United States Patent 11,629,340 (DHFR TUNABLE PROTEIN REGULATION) - sequence listing, part 2

SEQ ID NO: 7657 - protein, 576 aa, Artificial Sequence; identical to SEQ ID NO: 1157
  Description of Artificial Sequence: Synthetic Payload

SEQ ID NO: 7658 - protein, 431 aa, Artificial Sequence; identical to SEQ ID NO: 745
  Description of Artificial Sequence: Synthetic Payload

SEQ ID NO: 7659 - protein, 396 aa, Artificial Sequence; identical to SEQ ID NO: 747
  Description of Artificial Sequence: Synthetic Construct

SEQ ID NO: 7660 - protein, 543 aa, Artificial Sequence; identical to SEQ ID NO: 1160
  Description of Artificial Sequence: Synthetic Construct

SEQ ID NO: 7661 - protein, 594 aa, Artificial Sequence; identical to SEQ ID NO: 1161
  Description of Artificial Sequence: Synthetic Construct

SEQ ID NO: 7662 - protein, 540 aa, Artificial Sequence; identical to SEQ ID NO: 1162
  Description of Artificial Sequence: Synthetic Construct

SEQ ID NO: 7663 - protein, 591 aa, Artificial Sequence; identical to SEQ ID NO: 1163
  Description of Artificial Sequence: Synthetic Construct

SEQ ID NO: 7664 - protein, 505 aa, Artificial Sequence; identical to SEQ ID NO: 1164
  Description of Artificial Sequence: Synthetic Construct

SEQ ID NO: 7665 - protein, 556 aa, Artificial Sequence; identical to SEQ ID NO: 1165
  Description of Artificial Sequence: Synthetic Construct

SEQ ID NO: 7666 - protein, 505 aa, Artificial Sequence; identical to SEQ ID NO: 1166
  Description of Artificial Sequence: Synthetic Construct

SEQ ID NO: 7667 - protein, 556 aa, Artificial Sequence; identical to SEQ ID NO: 1167
  Description of Artificial Sequence: Synthetic Construct

SEQ ID NO: 7668 - protein, 490 aa, Artificial Sequence; identical to SEQ ID NO: 1168
  Description of Artificial Sequence: Synthetic Construct

SEQ ID NO: 7669 - protein, 599 aa, Artificial Sequence; identical to SEQ ID NO: 1169
  Description of Artificial Sequence: Synthetic Construct

SEQ ID NO: 7670 - protein, 650 aa, Artificial Sequence; identical to SEQ ID NO: 1170
  Description of Artificial Sequence: Synthetic Construct

SEQ ID NO: 7671 - protein, 686 aa, Artificial Sequence; identical to SEQ ID NO: 1171
  Description of Artificial Sequence: Synthetic Construct

SEQ ID NO: 7672 - protein, 107 aa, Homo sapiens; identical to SEQ ID NO: 192

SEQ ID NO: 7673 - protein, 159 aa, Escherichia coli [sequence omitted]

SEQ ID NO: 7674 - protein, 187 aa, Homo sapiens; identical to SEQ ID NO: 1

SEQ ID NO: 7675 - protein, 327 aa, Homo sapiens; identical to SEQ ID NO: 195

SEQ ID NO: 7676 - protein, 189 aa, Homo sapiens; identical to SEQ ID NO: 196

SEQ ID NO: 7677 - protein, 260 aa, Homo sapiens; identical to SEQ ID NO: 197

SEQ ID NO: 7678 - protein, 231 aa, Homo sapiens; identical to SEQ ID NO: 198

SEQ ID NO: 7679 - DNA, 714 bp, Homo sapiens; identical to SEQ ID NO: 1622

SEQ ID NO: 7680 - DNA, 711 bp, Artificial Sequence; identical to SEQ ID NO: 1623
  Description of Artificial Sequence: Synthetic construct

SEQ ID NO: 7681 - protein, 555 aa, Artificial Sequence; identical to SEQ ID NO: 1955
  Description of Artificial Sequence: Synthetic construct
